United States Patent 11,965,185 (LACHNOSPIRACEAE SP. CAS12A MUTANTS WITH ENHANCED CLEAVAGE ACTIVITY AT NON-CANONICAL TTTT PROTOSPACER ADJACENT MOTIFS) - sequence listing, part 2

SEQ ID NO: 889 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaaaaaaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 890 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKEKKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 891 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacacctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 892 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNTFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 893 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatccatgaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 894 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIHEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 895 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacaaaatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 896 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYKINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 897 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccctgtttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 898 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTLFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 899 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcccgatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 900 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSPIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 901 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatgcgcgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 902 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNARVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 903 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtgaaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 904 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVKQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 905 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaatattttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 906 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKYFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 907 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattaaaaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 908 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIKNNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 909 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgtgaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 910 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVVKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 911 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcaaccctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 912 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPATLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 913 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatgatgatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 914 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMMIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 915 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattgatccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 916 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLIDPVKNSDGIFYDSRNYEAQENAILPKNADANGAYNIARKVLWAIGQFKKAEDEKLDKVKIAISNKEWLEYAQTSVKH

SEQ ID NO: 917 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaaacatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 918 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSANIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 919 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatgcggaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 920 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNAENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 921 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattcagcaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 922 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYIQQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 923 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatatgaaattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 924 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYEIARKVLWAIGQFKKAEDEKLDKVKIAISNKEWLEYAQTSVKH

SEQ ID NO: 925 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacatttttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 926 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNIFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 927 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgcattaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 928 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCIKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 929 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatcagctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 930 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYQLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 931 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggaagaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 932 - protein, 1228 aa, Artificial Sequence
  Synthetic
MSKLEKFTNCYSLSKTLRFKAIPVGKTQENIDNKRLLEEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 933 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatcgtgaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 934 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIVKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 935 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacaactttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 936 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNNFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 937 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctataaagattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 938 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYKDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 939 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtggcgtattggccagtttaagaaagcagaagatgagaagctggacaaagtgaaaattgcgatcagcaataaagagtggctggaatacgcacagaccagcgttaaacat

SEQ ID NO: 940 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWRIGQFKKAEDEKLDKVKIAISNKEWLEYAQTSVKH

SEQ ID NO: 941 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaattgggaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 942 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNWEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 943 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagttttttaaagcagaagatgagaagctggacaaagtgaaaattgcgatcagcaataaagagtggctggaatacgcacagaccagcgttaaacat

SEQ ID NO: 944 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFFKAEDEKLDKVKIAISNKEWLEYAQTSVKH

SEQ ID NO: 945 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacaacgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 946 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNNVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 947 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcgaatacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 948 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSREYEAQENAILPKNADANGAYNIARKVLWAIGQFKKAEDEKLDKVKIAISNKEWLEYAQTSVKH

SEQ ID NO: 949 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatcatacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 950 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYHTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 951 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtaacggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 952 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGNGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 953 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgatctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 954 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFDLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 955 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaacgtgattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 956 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNVIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 957 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagccgaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 958 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEPKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 959 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaagatgaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 960 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKDEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 961 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatctgattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 962 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDLIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 963 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaatattaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 964 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNINSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 965 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgcagttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 966 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLQFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 967 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtgtgtttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 968 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGVFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 969 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaatgggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 970 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREWEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 971 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaacagtcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 972 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKQSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 973 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacgcggttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 974 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNAVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 975 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttggccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 976 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRWPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 977 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattattaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 978 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQIINKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 979 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttatgaatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 980 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFMNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 981 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattcgtgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 982 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIRDSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 983 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctgtctaaagtgaaaattgcgatcagcaataaagagtggctggaatacgcacagaccagcgttaaacat

SEQ ID NO: 984 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLSKVKIAISNKEWLEYAQTSVKH

SEQ ID NO: 985 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattccgtaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 986 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFRKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 987 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatgcggttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 988 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYAVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 989 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagccgtgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 990 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSRENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 991 - DNA, 3684 bp, Artificial Sequence
  Synthetic
atgagcaaactggaaaagttcaccaactgttatagcctgagcaaaaccctgcgttttcgtgcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 992 - protein, 1228 aa, Artificial Sequence
  Synthetic
MSKLEKFTNCYSLSKTLRFRAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 993 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaaccagcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 994 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINQQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 995 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcgataaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 996 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFDKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 997 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaaagaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 998 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINKEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 999 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaacagctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1000 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDREQLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1001 - DNA, 3684 bp, Artificial Sequence
  Synthetic
atgagcaaactggaaaagttcgcgaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1002 - protein, 1228 aa, Artificial Sequence
  Synthetic
MSKLEKFANCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1003 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcaaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1004 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVKKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1005 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccgtataatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1006 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPYNSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1007 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcatttgaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1008 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAFENAILPKNADANGAYNIARKVLWAIGQFKKAEDEKLDKVKIAISNKEWLEYAQTSVKH

SEQ ID NO: 1009 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggtggccagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1010 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGGQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1011 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatgcagctgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1012 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMQLMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1013 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaaaacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1014 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKNIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1015 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggcgaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1016 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMAKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1017 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagctgcaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1018 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSCKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1019 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaatttacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1020 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKIYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1021 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttctgttcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1022 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFLFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1023 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagtttttctgcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1024 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFSALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1025 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcgcgaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1026 - protein, 1228 aa, Artificial Sequence
  Synthetic
MSKLEKFTNCYSLSKTLRFKAIPVGKTQENIDNKRLLVEDEKRAEDYKGVKKLLDRYYLSFANDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1027 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatgatgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1028 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNDDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1029 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcggcaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1030 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASGKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1031 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagctggaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1032 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKLEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1033 - DNA, 3684 bp, Artificial Sequence
  Synthetic
atgagcaaaaacgaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1034 - protein, 1228 aa, Artificial Sequence
  Synthetic
MSKNEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1035 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcggcgaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1036 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGGETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1037 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgcgaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1038 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTAKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1039 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgaccctgtacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1040 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTLYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1041 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagcctgaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1042 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSLNYEAQENAILPKNADANGAYNIARKVLWAIGQFKKAEDEKLDKVKIAISNKEWLEYAQTSVKH

SEQ ID NO: 1043 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccgccgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1044 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPPKNSDGIFYDSRNYEAQENAILPKNADANGAYNIARKVLWAIGQFKKAEDEKLDKVKIAISNKEWLEYAQTSVKH

SEQ ID NO: 1045 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcatgagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1046 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESMSKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1047 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagccatctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1048 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSHLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1049 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttattgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1050 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFIEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1051 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaacagaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1052 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKQNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1053 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgatgataactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1054 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDDNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1055 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgtttacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1056 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLFTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1057 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcatgaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1058 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIMTILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1059 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatcaccgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1060 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGITVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1061 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgtggcggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1062 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRGGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1063 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgaccccgtacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1064 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTPYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1065 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgaacgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1066 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLNVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1067 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtggtggtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1068 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVVVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1069 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaggcagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1070 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAGSTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1071 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctggatacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1072 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLDTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1073 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgcgtctgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1074 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTRLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1075 - DNA, 3684 bp, Artificial Sequence
  Synthetic
atgagcaaactggaaaagttcaccaactgttatagcctgagcaaaaccctgcgtgaaaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1076 - protein, 1228 aa, Artificial Sequence
  Synthetic
MSKLEKFTNCYSLSKTLREKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1077 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcgaatatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1078 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGEYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1079 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcgtggaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1080 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGVETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1081 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgggcgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1082 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVGEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1083 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaccgaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1084 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGTETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1085 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatatgtttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1086 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYMFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1087 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatggcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1088 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDGIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1089 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaactatattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1090 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNYIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1091 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggccgtcgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1092 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGRRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1093 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctgtctaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1094 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELSNLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1095 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaccctgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1096 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSETLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1097 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctggatcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1098 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLDRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1099 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattctgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1100 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAILKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1101 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactggtgtatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1102 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLVYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1103 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatgatcacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1104 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDDHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1105 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaattctttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1106 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNSFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1107 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatattgccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1108 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYIAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1109 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatatcaggaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1110 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYQELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1111 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcaggatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1112 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNQDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1113 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggttgggaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1114 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGWELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1115 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgatattgcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1116 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDIAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1117 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaattcgtcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1118 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSIRRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1119 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatattttgaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1120 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYFELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1121 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtgaaaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1122 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRETLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1123 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtggcaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1124 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRGTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1125 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctggtggaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1126 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLVEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1127 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattccgagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1128 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIPSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1129 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatccatgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1130 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIHDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1131 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgaggaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1132 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEEMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1133 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagccagatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1134 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISQISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1135 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtattggcagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1136 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYWQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1137 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttaccaatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1138 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFTNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1139 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaccgtataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1140 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEPYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1141 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatatggtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1142 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYMVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1143 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgaaaaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1144 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLKKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1145 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactggcggaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1146 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLAEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1147 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcagaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1148 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMQNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1149 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacgaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1150 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNEYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1151 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaacgtacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1152 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKRTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1153 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatctcttatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1154 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGISYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1155 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaagtatgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1156 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKYVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1157 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaactatgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1158 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNYEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1159 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccagtacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1160 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTQYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1161 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcaaaaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1162 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSKKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1163 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagaggaaaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1164 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEEKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1165 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagagaaactggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1166 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEKLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1167 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacgcgatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1168 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYAINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1169 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcaatgattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1170 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAMIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1171 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagaggcgatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1172 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEAILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1173 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcggcccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1174 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFGPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1175 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaaaacaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1176 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKNKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1177 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtgacccagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1178 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVTQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1179 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccggatgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1180 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPDEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1181 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttatgtgagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1182 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYVSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1183 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatgaatccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1184 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYESIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1185 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgacccctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1186 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLTPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1187 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacgatgatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1188 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNDDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1189 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgtgcaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1190 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLCKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1191 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgcggaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1192 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDAEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1193 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactgcgtgatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1194 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALRDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1195 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtgaagcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1196 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGEAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1197 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggatattaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1198 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDIKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1199 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatccggcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1200 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANPAYNIARKVLWAIGQFKKAEDEKLDKVKIAISNKEWLEYAQTSVKH

SEQ ID NO: 1201 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcattgcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1202 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHCPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1203 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtcgtagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1204 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRRSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1205 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcattgaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1206 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGIETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1207 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagcgcggaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1208 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSAESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1209 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacccgaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1210 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADPKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1211 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcatttctcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1212 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGISRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1213 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttctctaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1214 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFSKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1215 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgataacaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1216 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDNNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1217 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttattataaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1218 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYYKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1219 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagaccgtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1220 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICETVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1221 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaatcaggatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1222 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNQDGIFYDSRNYEAQENAILPKNADANGAYNIARKVLWAIGQFKKAEDEKLDKVKIAISNKEWLEYAQTSVKH

SEQ ID NO: 1223 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctggtgagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1224 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLVSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1225 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtacaaccagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1226 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYNQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1227 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacctgattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1228 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNLIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1229 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttttttttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1230 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFFFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1231 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgtggttcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1232 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPWFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1233 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaggcagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1234 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEGSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1235 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccatgtatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1236 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAMYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1237 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaaaaggccagtttaagaaagcagaagatgagaagctggacaaagtgaaaattgcgatcagcaataaagagtggctggaatacgcacagaccagcgttaaacat

SEQ ID NO: 1238 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAKGQFKKAEDEKLDKVKIAISNKEWLEYAQTSVKH

SEQ ID NO: 1239 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattaaaagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1240 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFIKSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1241 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggctttttttctaatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1242 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFSNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1243 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgtctttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1244 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLSFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1245 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaagaagcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1246 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKEAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1247 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgtaccgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1248 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERTEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1249 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcatgcggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1250 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCACGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1251 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacagaccctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1252 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQTLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1253 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatctttaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1254 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIIFNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1255 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatctgtttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1256 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNLFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1257 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctgcattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1258 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTCIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1259 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggttggtttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1260 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGWFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1261 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaatgcaaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1262 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKCKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1263 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagtgcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1264 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKCDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1265 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcgcgtatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1266 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSAYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1267 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaaccgtgagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1268 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENRELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1269 - DNA, 3684 bp, Artificial Sequence
  Synthetic
atgagcaaactggaaaagttcaccaactgttatagcctgagcaaaaccctgcgttttaaagcaattccgcagggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1270 - protein, 1228 aa, Artificial Sequence
  Synthetic
MSKLEKFTNCYSLSKTLRFKAIPQGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1271 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcattctccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1272 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHSPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1273 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaacagctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1274 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINEQLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1275 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattgatggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1276 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIDGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1277 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcggcgatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1278 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVGDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1279 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacctgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1280 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTCYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1281 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggccgtatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1282 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGRIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1283 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgatgaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1284 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMMNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1285 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggctggtatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1286 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGWYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1287 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagctataagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1288 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSYKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1289 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaagtgaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1290 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKEVNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1291 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaggcggccagtttaagaaagcagaagatgagaagctggacaaagtgaaaattgcgatcagcaataaagagtggctggaatacgcacagaccagcgttaaacat

SEQ ID NO: 1292 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAGGQFKKAEDEKLDKVKIAISNKEWLEYAQTSVKH

SEQ ID NO: 1293 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagctgcagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1294 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSCSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1295 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttcaggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1296 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVQEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1297 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagggcgtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1298 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICEGVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1299 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaccccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1300 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFTPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1301 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggtttggcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1302 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVWHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1303 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgaacatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1304 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELNMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1305 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagcatgaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1306 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKEHENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1307 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatatttgccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1308 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYICQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1309 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaatgataacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1310 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNDNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1311 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagcagttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1312 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKQFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1313 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtgtgaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1314 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGVKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1315 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggttgggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1316 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGWAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1317 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggttataataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1318 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGYNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1319 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtggtgaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1320 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVVNSDGIFYDSRNYEAQENAILPKNADANGAYNIARKVLWAIGQFKKAEDEKLDKVKIAISNKEWLEYAQTSVKH

SEQ ID NO: 1321 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgccataaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1322 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCHKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1323 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagtctctgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1324 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQSLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1325 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcaacgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1326 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDINETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1327 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaaccgatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1328 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKPIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1329 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatctgcattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1330 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHICIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1331 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatgatggacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1332 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMMDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1333 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtatctgcagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1334 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYLQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1335 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaaaacgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1336 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFENALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1337 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgatgacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1338 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLMTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1339 - DNA, 3684 bp, Artificial Sequence
  Synthetic
atgagcaaactggaaaagttcaccaactgttatagcctgagcaaaaccctgcgttttaaagcaattccggttggtaaaacccaagagtatattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1340 - protein, 1228 aa, Artificial Sequence
  Synthetic
MSKLEKFTNCYSLSKTLRFKAIPVGKTQEYIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1341 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgaccccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1342 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMTPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1343 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtgtgcaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1344 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVCKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1345 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtgtggcagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1346 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVWQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1347 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaatgctatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1348 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKCYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1349 - DNA, 3684 bp, Artificial Sequence
  Synthetic
atgagcaaactggaaaagttcaccaactgttatagcctgagcaaaaccctgcgttttaaagcaattccggttggttgcacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1350 - protein, 1228 aa, Artificial Sequence
  Synthetic
MSKLEKFTNCYSLSKTLRFKAIPVGCTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1351 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaaggcgaagatgagaagctggacaaagtgaaaattgcgatcagcaataaagagtggctggaatacgcacagaccagcgttaaacat

SEQ ID NO: 1352 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKGEDEKLDKVKIAISNKEWLEYAQTSVKH

SEQ ID NO: 1353 - DNA, 3684 bp, Artificial Sequence
  Synthetic
atgagcaaactggaaaagttcaccaactgttatagcctggtgaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1354 - protein, 1228 aa, Artificial Sequence
  Synthetic
MSKLEKFTNCYSLVKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1355 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaatattatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1356 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKYYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1357 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacaggcgctgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1358 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQALPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1359 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctgcatatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1360 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLHINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1361 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaccttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1362 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFTFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1363 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcctgaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1364 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRLKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1365 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttctgggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1366 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFLGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1367 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcattgatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1368 - protein, 1228 aa, Artificial Sequence
  Synthetic
MSKLEKFTNCYSLSKTLRFKAIPVGKTQENIDNKRLLVIDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1369 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatattatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1370 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDIIFYDSRNYEAQENAILPKNADANGAYNIARKVLWAIGQFKKAEDEKLDKVKIAISNKEWLEYAQTSVKH

SEQ ID NO: 1371 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgtctctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1372 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLSLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1373 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatcgaaaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1374 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIEKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1375 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttaacctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1376 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFNLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1377 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatattaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1378 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCININLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1379 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcgaaatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1380 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDREMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1381 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccctgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1382 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTLTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1383 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatgaaacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1384 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENETRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1385 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacctggaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1386 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINLEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1387 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattattctacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1388 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYSTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1389 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcaaaaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1390 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKIKNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1391 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaatgcgatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1392 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENAIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1393 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaaccgaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1394 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKPKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1395 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcgatgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1396 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFDEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1397 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaatttctcagtttaagaaagcagaagatgagaagctggacaaagtgaaaattgcgatcagcaataaagagtggctggaatacgcacagaccagcgttaaacat

SEQ ID NO: 1398 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAISQFKKAEDEKLDKVKIAISNKEWLEYAQTSVKH

SEQ ID NO: 1399 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgattggaaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1400 - protein, 1228 aa, Artificial Sequence
  Synthetic
MSKLEKFTNCYSLSKTLRFKAIPVGKTQENIDWKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1401 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaatcatatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1402 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNHMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1403 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaatctgaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1404 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKSEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1405 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatatgccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1406 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYMPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1407 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatccgtgaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1408 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIREQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1409 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgttatctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1410 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICYLVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1411 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaacgaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1412 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGNETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1413 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggctttttttgcaatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1414 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFCNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1415 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggatcgtgataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1416 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDRDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1417 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaccggaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1418 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKPEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1419 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttcagcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1420 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVQHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1421 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatccagaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1422 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIQTILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1423 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgattggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1424 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLIGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1425 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaagcgctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1426 - protein, 1228 aa, Artificial Sequence
  Synthetic
MSKLEKFTNCYSLSKTLRFKAIPVGKTQENIDNKALLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1427 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatatggataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1428 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHMDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1429 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatgattccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1430 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYDSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1431 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtctggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1432 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISLVKNSDGIFYDSRNYEAQENAILPKNADANGAYNIARKVLWAIGQFKKAEDEKLDKVKIAISNKEWLEYAQTSVKH

SEQ ID NO: 1433 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcgcgaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1434 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSAKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1435 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatctgctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1436 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYLLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1437 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtgcgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1438 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLCEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1439 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttcatctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1440 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFHLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1441 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaaaacgcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1442 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSENAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1443 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcaaaattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1444 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIKIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1445 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaacgttataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1446 - protein, 1228 aa, Artificial Sequence
  Synthetic
MSKLEKFTNCYSLSKTLRFKAIPVGKTQENIDNKRLLVEDEKRAERYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1447 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagccagagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1448 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESQSKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1449 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagcgaagatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1450 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSEDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1451 - DNA, 3684 bp, Artificial Sequence
  Synthetic
atgagcaaactggaaaagttcaccaactgttatagcctgagcaaaaccctgcgttttaaagcaattccggttggtaaaacccaagagtttattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1452 - protein, 1228 aa, Artificial Sequence
  Synthetic
MSKLEKFTNCYSLSKTLRFKAIPVGKTQEFIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1453 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtcgtcgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1454 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGRRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1455 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcgaaaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1456 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCEKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1457 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtaacctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1458 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICNLVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1459 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaacagacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1460 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKQTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1461 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagttgcaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1462 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASCKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1463 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgccttatccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1464 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPYPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1465 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatgataatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1466 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDDNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1467 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttgcgagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1468 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFASMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1469 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagccgtaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1470 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSRTGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1471 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacctttaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1472 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTFTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1473 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaatgcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1474 - protein, 1228 aa, Artificial Sequence
  Synthetic
MSKLEKFTNCYSLSKTLRFKAIPVGKTQENIDNKRLLVEDEKRAEDYKCVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1475 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaaccgaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1476 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKPKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1477 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgatccggcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1478 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDPAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1479 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattggcatcagcaataaagagtggctggaatacgcacagaccagcgttaaacat

SEQ ID NO: 1480 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIGISNKEWLEYAQTSVKH

SEQ ID NO: 1481 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaatgcaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1482 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKCTNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1483 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaaccgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1484 - protein, 1228 aa, Artificial Sequence
  Synthetic
MSKLEKFTNCYSLSKTLRFKAIPVGKTQENIDNKRLLVEDEKRAEDYKTVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1485 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaaatggaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1486 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKMEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1487 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttattaatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1488 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFINRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1489 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagtctgtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1490 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQSVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1491 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacacctgcaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1492 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTCNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1493 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgcagaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1494 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPQNADANGAYNIARKVLWAIGQFKKAEDEKLDKVKIAISNKEWLEYAQTSVKH

SEQ ID NO: 1495 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagcgtagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1496 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQRSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1497 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtttttttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1498 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGFFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1499 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgggcttcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1500 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPGFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1501 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgaaatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1502 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNEIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1503 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtccaggatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1504 - protein, 1228 aa, Artificial Sequence
  Synthetic
MSKLEKFTNCYSLSKTLRFKAIPVGKTQENIDNKRLLVQDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1505 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctataaatttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1506 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYKFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1507 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgatgtggcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1508 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDVAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1509 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgtttttccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1510 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVFPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1511 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgggcagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1512 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPGSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1513 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaaccctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1514 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKTLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1515 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaaaaagttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1516 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEEKVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1517 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcctgagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1518 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESLSKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1519 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgtgtatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1520 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNVYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1521 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagccgatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1522 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQPIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1523 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagcctttaccggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1524 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFTGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1525 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttctatgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1526 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFYENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1527 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattggcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1528 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIGNNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1529 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacaggatcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1530 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQDQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1531 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccattcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1532 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITIRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1533 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagcgctgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1534 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKALKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1535 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtgcatgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1536 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVHAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1537 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattacccgtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1538 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITRRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1539 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagtatctggacaaagtgaaaattgcgatcagcaataaagagtggctggaatacgcacagaccagcgttaaacat

SEQ ID NO: 1540 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEYLDKVKIAISNKEWLEYAQTSVKH

SEQ ID NO: 1541 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacggcctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1542 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNGLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1543 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtaaactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1544 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGKLKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1545 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaacagtgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1546 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEQCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1547 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaagcgaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1548 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKAKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1549 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattaccgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1550 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYITVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1551 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgaaacagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1552 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMKQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1553 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagataaagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1554 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADKDLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1555 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacaaagattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1556 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNKDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1557 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatgcgtttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1558 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNAFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1559 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagcatccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1560 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQHPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1561 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgtttggccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1562 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVWPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1563 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattccgtctggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1564 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFRLDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1565 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggttggagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1566 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGWSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1567 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttttttgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1568 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFFCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1569 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttatgaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1570 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYESLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1571 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggccgtttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1572 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGRFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1573 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgggcgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1574 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLGEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1575 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagttataacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1576 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSYNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1577 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaacctctcagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1578 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTSQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1579 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcctgctgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1580 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFLLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1581 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattcattttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1582 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIHFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1583 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtatgaacagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1584 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYEQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1585 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtcgtaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1586 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGRKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1587 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcatgaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1588 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHEICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1589 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaactgtttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1590 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKLFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1591 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtgatggaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1592 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVMEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1593 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattcataacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1594 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIHNNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1595 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccgatgcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1596 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIADAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1597 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgttataccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1598 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCYTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1599 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgttttatttcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1600 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFYFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1601 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatctgattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1602 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDLIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1603 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaaccgctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1604 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEPLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1605 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagcatgtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1606 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICEHVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1607 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgacctatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1608 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLTYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1609 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatataaatccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1610 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYKSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1611 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatcgttccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1612 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYRSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1613 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatgatctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1614 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDDLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1615 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagttaaccgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1616 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVNRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1617 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttatctggcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1618 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYLAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1619 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgatgatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1620 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLMMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1621 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctcccgtgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1622 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSRADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1623 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaccagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1624 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEATSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1625 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgcatcgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1626 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLHRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1627 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgcgtggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1628 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALRGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1629 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatatatgattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1630 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYMIARKVLWAIGQFKKAEDEKLDKVKIAISNKEWLEYAQTSVKH

SEQ ID NO: 1631 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgattgatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1632 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMIDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1633 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgatggatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1634 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMMDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1635 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaagaactgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1636 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKELKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1637 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaaattttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1638 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKIFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1639 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgcgtatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1640 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTAYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1641 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaattgcgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1642 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNCAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1643 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgaccccggaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1644 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTPEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1645 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttattgcagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1646 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYCSQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1647 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgcaggtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1648 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPQVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1649 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagattgcgatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1650 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADCDLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1651 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatataatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1652 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKYNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1653 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttccgaaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1654 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVPKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1655 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcatgatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1656 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGMMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1657 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgaacaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1658 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILNKNADANGAYNIARKVLWAIGQFKKAEDEKLDKVKIAISNKEWLEYAQTSVKH

SEQ ID NO: 1659 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaataaaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1660 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENKILPKNADANGAYNIARKVLWAIGQFKKAEDEKLDKVKIAISNKEWLEYAQTSVKH

SEQ ID NO: 1661 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgtgccacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1662 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVCHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1663 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgggctttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1664 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPGFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1665 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgattttgcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1666 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDFAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1667 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgccgggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1668 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMPGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1669 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgaccacctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1670 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTTYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1671 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgatcaggtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1672 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDQVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1673 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgatggcgcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1674 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDGAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1675 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaccgatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1676 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQPIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1677 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacaccattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1678 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNTIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1679 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatcttttttatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1680 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFFINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1681 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttataccgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1682 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYTAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1683 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatggtgctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1684 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMVLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1685 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcattctgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1686 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFILYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1687 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgggcaaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1688 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLGKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1689 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaataccttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1690 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNTFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1691 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgcagtatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1692 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLQYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1693 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctatgatgtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1694 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYDVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1695 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagcctttaacggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1696 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFNGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1697 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaatgc

SEQ ID NO: 1698 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKC

SEQ ID NO: 1699 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcatgtatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1700 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSMYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1701 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctatctgaacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1702 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYLNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1703 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatgcgcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1704 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDARALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1705 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattccgtccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1706 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFRPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1707 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgcatcaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1708 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLHQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1709 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactattttaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1710 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYFKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1711 - DNA, 3684 bp, Artificial Sequence
  Synthetic
atgagcaaactggaaaagttcaccaactgttatagcctgagcaaaggcctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1712 - protein, 1228 aa, Artificial Sequence
  Synthetic
MSKLEKFTNCYSLSKGLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1713 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagggcctgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1714 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQGLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1715 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttaaagaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1716 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFKEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1717 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaacatatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1718 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEHIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1719 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctctgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1720 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSSDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1721 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattaacaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1722 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEINNNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1723 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattgatctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1724 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIDLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1725 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgtggacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1726 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLWTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1727 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgattattggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1728 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDYWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1729 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatccgttacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1730 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKIRYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1731 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgtcgtgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1732 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERREARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1733 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcaccaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1734 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKITNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1735 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgttttttggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1736 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFFGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1737 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgattctgcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1738 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDSAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1739 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaagtgtacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1740 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEVYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1741 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagctatagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1742 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESYSKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1743 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaattgcgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1744 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNCEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1745 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaacagctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1746 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKQLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1747 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctgtgcaaagtgaaaattgcgatcagcaataaagagtggctggaatacgcacagaccagcgttaaacat

SEQ ID NO: 1748 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLCKVKIAISNKEWLEYAQTSVKH

SEQ ID NO: 1749 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgattgccgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1750 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDCRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1751 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaatatagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1752 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEYSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1753 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttgaagcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1754 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFEALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1755 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggtttatgaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1756 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVYEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1757 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaccgaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1758 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKPNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1759 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttggggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1760 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRWGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1761 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacagatgctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1762 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQMLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1763 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaactggagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1764 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFELEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1765 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagatggataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1766 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQMDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1767 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaaaccaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1768 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEETKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1769 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaaaaaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1770 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEKKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1771 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatatttccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1772 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYISIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1773 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgattgggcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1774 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDWAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1775 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgtggcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1776 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMWRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1777 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagactttcgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1778 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDFRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1779 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagcgatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1780 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKAIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1781 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgatctgtggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1782 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDLWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1783 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctggaacgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1784 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLERYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1785 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagcatctgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1786 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQHLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1787 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgaaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1788 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCETGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1789 - DNA, 3684 bp, Artificial Sequence
  Synthetic
atgagcaaactggaaaagttcaccaactgttatagcctgagcaaaaccctgcgttttaaagcaattccggttggtaaaccgcaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1790 - protein, 1228 aa, Artificial Sequence
  Synthetic
MSKLEKFTNCYSLSKTLRFKAIPVGKPQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1791 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctgggcaaagtgaaaattgcgatcagcaataaagagtggctggaatacgcacagaccagcgttaaacat

SEQ ID NO: 1792 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLGKVKIAISNKEWLEYAQTSVKH

SEQ ID NO: 1793 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggacgtgatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1794 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDVIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1795 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtcagaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1796 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRQTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1797 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactgcgtgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1798 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELRVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1799 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaattatgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1800 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNYDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1801 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaaatggatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1802 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKMDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1803 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaaatgttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1804 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKEMFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1805 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggccatgtataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1806 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAMYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1807 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgaggaagtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1808 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICEEVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1809 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttgatgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1810 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFDEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1811 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatggatcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1812 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMDRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1813 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaatctgatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1814 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNLMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1815 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcatacctcttactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1816 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTSYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1817 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctgtgcgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1818 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLCDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1819 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttacccatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1820 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVTHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1821 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgttgcagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1822 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRCSLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1823 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaacgtagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1824 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKRSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1825 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatgtgccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1826 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANVPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1827 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctgaacaaagtgaaaattgcgatcagcaataaagagtggctggaatacgcacagaccagcgttaaacat

SEQ ID NO: 1828 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLNKVKIAISNKEWLEYAQTSVKH

SEQ ID NO: 1829 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgcataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1830 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPHKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1831 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtgaatttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1832 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGEFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1833 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgtgcttcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1834 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPCFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1835 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttctgagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1836 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFLSASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1837 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatctgccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1838 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNLPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1839 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgggcaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1840 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLGKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1841 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagtttgctgggcaattggccagtttaagaaagcagaagatgagaagctggacaaagtgaaaattgcgatcagcaataaagagtggctggaatacgcacagaccagcgttaaacat

SEQ ID NO: 1842 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVCWAIGQFKKAEDEKLDKVKIAISNKEWLEYAQTSVKH

SEQ ID NO: 1843 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccattgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1844 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTIAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1845 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcatacctgctactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1846 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTCYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1847 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatataactccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1848 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYNSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1849 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttaccgcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1850 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFTARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1851 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgccggaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1852 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLPEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1853 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttatggagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1854 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFMEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1855 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaacaccaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1856 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINTKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1857 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcggcgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1858 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFGENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1859 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgcgttcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1860 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFAFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1861 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttaacggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1862 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFNGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1863 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaaccatgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1864 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNHVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1865 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagtctatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1866 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQSIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1867 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaccctgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1868 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQTLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1869 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttaccttcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1870 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFTFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1871 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagtgcctgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1872 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQCLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1873 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagtctccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1874 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQSPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1875 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggcgaaagtgaaaattgcgatcagcaataaagagtggctggaatacgcacagaccagcgttaaacat

SEQ ID NO: 1876 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLAKVKIAISNKEWLEYAQTSVKH

SEQ ID NO: 1877 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatgtgcaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1878 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMCKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1879 - DNA, 3684 bp, Artificial Sequence
  Synthetic
atgagcaaactggaaaagttcaccaactgttatagcctgcagaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1880 - protein, 1228 aa, Artificial Sequence
  Synthetic
MSKLEKFTNCYSLQKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1881 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgagcgtcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1882 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSERQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1883 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtgtgagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1884 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRVSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1885 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagggcagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1886 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQGSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1887 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctggcggtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1888 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLAVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1889 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaattgggatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1890 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNWDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1891 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacattgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1892 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYIAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1893 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccagaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1894 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSQNYEAQENAILPKNADANGAYNIARKVLWAIGQFKKAEDEKLDKVKIAISNKEWLEYAQTSVKH

SEQ ID NO: 1895 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtggtggattggccagtttaagaaagcagaagatgagaagctggacaaagtgaaaattgcgatcagcaataaagagtggctggaatacgcacagaccagcgttaaacat

SEQ ID NO: 1896 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWWIGQFKKAEDEKLDKVKIAISNKEWLEYAQTSVKH

SEQ ID NO: 1897 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtgcagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1898 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLCSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1899 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaataaaccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1900 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANKPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1901 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataccgcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1902 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDTAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1903 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaccgatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1904 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEPINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1905 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaataacaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1906 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNNNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1907 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgggcaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1908 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLGNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1909 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttctgcctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1910 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFCLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1911 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaatttaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1912 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKFKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1913 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagccgtgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1914 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSRDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1915 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtccgagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1916 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRPSLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1917 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgactttaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1918 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADFKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1919 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcgtgcgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1920 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFVRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1921 - DNA, 3684 bp, Artificial Sequence
  Synthetic
atgagcaaactggaaaagttcaccaactgttatagcctgagcaaaaccctgcgttttaaagcacgtccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1922 - protein, 1228 aa, Artificial Sequence
  Synthetic
MSKLEKFTNCYSLSKTLRFKARPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1923 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacgaaagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1924 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYESNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1925 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaactgctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1926 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINELLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1927 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacgtgaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1928 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADVKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1929 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaacagatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1930 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKQIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1931 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgaccatgtacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1932 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTMYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1933 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgacctatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1934 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISTYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1935 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgaccgcgtacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1936 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTAYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1937 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtgctggaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1938 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVLEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1939 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcattcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat
